United States Patent 10,233,495 (METHODS AND COMPOSITIONS FOR SCREENING AND TREATING DEVELOPMENTAL DISORDERS) - sequence listing, part 204

SEQ ID NO: 1635 - DNA, 72384 bp, Homo sapiens
gggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgttacacttcaatcacatgaagaaaactgaaggagagaaaaataagagagaacatctgggccaggacaggtagaagctgtcggcacctcagggcctatctaggtctgctgtggccacgcctgagggaagaagggatgtggaggaagggacctgagcctccctccgctcatccccccaagaacaaaggcagagttggggcaaaccctgctccctcttctaaaaggcacagcctacagggtcaagcaatggcaagtgagaggcatccactggttttggaggatggaaggtggcctgaggcaggtgacagaccttgcagaacagagaagcaggagcccagtgccccacagggggctgatgaggaccacgccggtgctacagaggccctgatgaggctcagcccacaaggccttgggttccaggaggagggtcaagggacagaaaggccctggccccccaccctgccctgctgatgccacctcattactgggccacaccacacagtccaagagtttcgggtccaaaccctgaaggtgatggcgcatacctctctatcctctccagggcatgaagtggggcccgagatgccaattcacaagggtgctggcaaaacacgaagcaaaatgaaccaagccctcagtgagctccagaggctcctcagacagcccctgcctcctcaggggtccgagggctcacgctgtctgccagactcaagcctcctgcacacacagccacggtctgcagagaggcccctccaggctcctccaaggctggtcagtacccctgggcagaggccactgatggccctaatcaaaaccacacctaaacacacccacaggctccagggaaggttgtctggcagccaaccctgtcccttgggtcagtggggaacccctaagccttccagaatttccctcaggccataccattagtgctcccttttggagaataatattccatgcactgaatcactcatggctttaggcataaagcgtgaaggagggggtgaatgggagtcagctgagctttctgatgcgcaaggcaacatccttccaggcaccagcatacctgggcaggagcccaccggccacagcgtcaggcacacctctccccagtcgtctgagtcagagcctccacatctttgagaagctcatcaagataccatggtgtatttagcccttccacatcctattctgcctcctggggtccatgagtctttcctgaggctcttcctggggtcctgtgtccatgcgccttggccacccctcctcagccacactcagagaatccagggtttcaacaatgcagcagtgtggggaaggcaggaatgccaggctgggaggcttcctccagatggggctctcaaacctgaccacactgcccaggagcttgctaaaaaggcagtgccaaggcgccatcctcagagatccttcctgcccccattggtgtgtgggactcagtgctcagggaggcggcaccagttaaaactcggcttgggatgcagggcctctggtccaggggaagagagcccaccacactgagtgccagcctgccacatgcacaggggacagtggagaacgcatccagggatcggggggacacaaggcatgggatggggacacagcatcatgcccagcacaatgggacccaacaagggaggaggctgcagccacacaggcaggacgggttgagggccaagacagggcccgggaagtcacttccccgagatgaagcagatgatgaccaacagggacccctcccatcacaaggctctggatacccaccccatcacctgagcagagacctgcacaaagtgagacacagataatacccctgacaccccaatgagaaagagagaagagggacagcacatggaaatagggcagacccagccagaagcaaactacttcatggtgacaaaaagcttgcaagttaaagccttgagtcatcacttggcacctgtgaaatctgcaaaaataatgttaaaggtaatatagagtgtgagcttaagcgtcagggaaaagccagggtcactggcaggaaaaggagagaaatggacagcaggtatccccaagcacctccctggagcaaagacatggcagcaggcatcgtctagggcaccgcgcatccatgtgtgtttgtgtgaccttgtgtgcgcatgtatacatgtgcttgagtgtacatgtgtgcctgagcaggtgtgcgtatgcacatgtgtgctttctgcatgtgtgcataggcatgggtgtgtgtacatagttgcatgcatgcattacgagtatgcaggcctatgcatgtgtgcatgtctgcacctgcgcctataaaacagacaagcatccacataccaaaagtctaatcagggtgccttcctccactggccagcatacaccttctctccgtctctcgcgccctccctcctcctcttctctccatttagccttatcaagtgcttcccaagttctctccaattactatgaatggcttcatcacagcataacacagtacgtgctcatcttctaaaaccaggacatgaggcatccctgctcccactaagactgtgcaaagttaaggctggagcagcagtggcccactcagggctcgcccctccctcggagcccttcacaggctcctggagaagagagactcagaggagaccctgcctgagagctcacacctgagatcacctggtgtgtaggggacaagggggggatgcttaggaccataggggggtctcagggccagcctggccttgtgggagggtctcagggccagcctaaccttgtgagggtcttaagaccaggctggccttgtagggggtcttaggaccagcgtggccttgtggggagtctcaggaccagtctaacattgtagggtatctcaggaccagcctggccttatagagggtcttgggaccaggctaaccttgcagggaatcttgtgacaagcctagccttgttgggggtctcataaccagcctagccttatagaggatctcagggccagtgtggccttgtgagggggtcttggggccagcctgctctatggaaattggaggcaccagtcaaggagagaggcttctgtctccctgggtccttggtttccacccatccttggccagtaccttcactcctccccgaccccggaggctcctagtctgttctcctgcttcacctgccctccaatggagcccctggccatcatgggcccaggccccggagctgatccctgaccccactgttgtgcccctaactcccactctccccctcctcccctcccctcccccccacctccatttcccctcagcctctgccctctccagaccacagacacagtcctcctgaccccggctcctcctgagctgcctcccaacctctcttttcttcttacctacatttctagaaagagcagctgcatctgctattttgcagccaattctgcctcctccctccagtccctgctgtgctcatcagaggcaccaggctaacgcacggcgtgggttccaaccaagcccaggcctgaacgcactcatgccaggatgcctagctggctccgctctccccaaactcagctgctactcctcagggatcccacgacacccagccccatagaagtcccagggaccatcccagcatggccccagcacatagaccacagagcttctctgcctgaatgtcccaggaccgccatgtgatgtctcctctcccacagggaatagagccctgtcctgcagacactcaggcacaggcaaacagagacccagccattgtacctgtgggcggggatctgggctcagcacagcccacctgcccatcaggggagtgggccacacaggccaaggcggccaggcctgacgcaggtgtgcctgagacccgccttcaggaggattagccatcatagattgagacccgcctttggggggcggagggagggggggtgctgcagattgagacctgccttcaggagggtttgccatcacagagtaacacctgcccctcaggagggttagccatgtcgacttaaaggggtcttcaggggagttagccgtggctagtttatgtgtgcctacaggagggttagccgccgcagattgagacctgccttcgggggtgttgtatcgcagattgagacctgtcttcaggagggttagccatcgcagagtcagacctgccttcagcagggttagccatcgcagattgtctggtttcctacccttgagctgctcagtgtacttcaccgaactgcagtactttagatagctctactactaccgtttttgacagtttacttatatttcatttaagtttagtgggggaaagcctgggttccccagcctccttgttcactgccccagccccatgtccacatacactcctgcaactctgcaaagacaccagggtgctgtgagggtcccgtgggtttccccaggtcctcttttggcaggtccctataacatgttgcagggcaggggagaggctgtctgtgatgggcagggcccctgactgccattcgggcaagtggggatactgagggaccctgaaagatatcagggtcaggctggtagggcatgtgggcagcaatgcatctcagggagtcctgccccctcttccatgggaagggcccacagctgccatccccatgagccagagaggatgacactctaggctggtggaaagggacctgatatcaaatggaaatgaggcaacccacgaatacacaagtctgcacgtgcttctgtgcatgtgtctgttcctagagcagacacaaatgttccagaagtttctttcttagtcattcacagaatcacaggctctcgaagaaggggtattattcattctaatcagtggtgcctggaatgatgccctgtagtttctttacttgccccagacacctgcagctccctggagagagcccctcagctcctggcaactccatacgttctgtggcagctgcagggtattccactgggtaggtgggctgccacacatgtaagaggtcctctagcaaaagacaccaaggtgctttacagtctttggcaacgaaaaacactcctgcaatgggcattattgatgaaaagtttttattcaaatgtgtgaccacatataaaagatgaactcctaatacttgatgtgctgggtcaaaggttatgatcattgtaagtttaaagagacatcccagaagtgctttcaatagagtatagccaggtagtgaaaatggtggagtaaggacctccaaaaaccctctcttccataaacgcaacaagaaaaccagcaaaaaacaaaaaggtcagaatccacatttttagaacttccaaaattaactaaacgcttgcagaaatcttaggaggatttattcaaaaaacataactgaatctcagtaagaattgcaaattttatagcacttgaacttgccctagtcccatccctgactctctatcccaagtgccttgaaaagtaggaccccacattcatcatgaaaaccactggcgtagcagcccctggagggaaaacagcaatggaactctttcaaagcttcattctcagaaaactgtcattatttgacctgtccagtagttcccatggagaccccacttacaaggatgtctgtatttgacctgactcagaggtctcaagtacaaaaatcatattccccaaggttcattgtcaaaaacaattactggtatttaatttcacaaatgcctgaagcagtagataacagtgaagcaagcaatagactaaccagaaagcttaaaaggaaagtttcagtaatgacatgatcataggggttttgaaaaactgcagtgcattcctgagaatctagaaggtcaagtgcatgctcagggctgtgcacatgctcagaaaagtacttgggaaaccctaagcactcacttctggctgactttgagtctctgtgcaagcaggaagagaagactaaggcagagttatcagctgcttagctgagagctgaaagcatacccaaagacacagagccccttagcgaagactgagaactttattgactccaggcacttatgaaaatttctttccaatcattatttgaccgctaagataactgagcagagatttcagtgccacacacaaaagaatacagactttgcagaagtaatccagaaatgtcacaaaacaaacaaccattactacaataaacagcagcaacaacaaaccccaaagagtggggagaatctgatttccagaattgacttactaaacaaaaactttcaatcagctactttaagtatattttttaaagactgaaggaattgatgtttaaagaactaaaggaaagtatggaagcaatatatcaaacagagaatatcaataaaggaatacaaattataaaaaagaaccaagcagaaattctggtgttgaaaactaagtaaatgaaatgaaacatagcaagaggggctcaacaacaggtttgaacagagagaagaaagaatcagtgacttgaaaaaacgtccattgagattatccagtctgaggcacagaaagaaaaaagaaaggaacaaataaatagagccacagacaccataatggacactatcatatgtataagaagagtctcagaaaaagaggagagtgagaaataaggcagaaaaaaaatattagaagcaataatggctaaaattttctaagttagatgaaaatattcatctccatatcctaaaagttcaacaaactccaggtagatttcttatcaggaaccatgaagggcaggaagcagttgagctgacacgttcaaaatactgaaagaaaagaggtgtcaaccatgaattctttatgcagcaaaattgtcattcaaatatgaaagggaaattacctgacaaataaaatagagaactcgtcagaagaagacctgccttataagaactactaaagagagtccttcaggctgaaatagtaggacaataagcagcaacttgaaatcatgtgaaaaaataaagaggaccattaaaggtaactttactggttttatatttattgctatatattagtaaatataaaagatagtataaacacattttatgcacttaactctatttttctcctatttgaattaaaagacaactggtctatgaccatactaccctgaatgtgcctgaattaaaagacaactgcatgaaacaataattataagtatagattgatgagcacacaaggtataaaaatgtaaattttatggcagtaacagcacaaaggagaggagaggcaacagaactacagaggagcaaagtttttgaatactgttgcaattgagtttgtattaatctgaacattgacatgtacatataacatatacatagttatttgttaagatattaattataaccctacaggcaacaggtaagaaaataactcaaaaatatacaataaaggaaaagacagaaattaaaatggtacactagataatatctaaatatctatttaacacaaaagaagaaaataatgaaggaataaaggaacaaaaatggcataagacataaaaaacaaatagcaaatcctaccttatcagtatttacattaaatgtaaatgaattaaacactccagttaagagtcagagattatcagagttaaaaaaaaaaacatgatccaactacatggctttctaaaatagacccactttagagagaagaacacaaataagttgaaagtgaaaatatggccggatgcagaggctcacgcctgtaatcccagcactttgggaggctaaggtgggtggatcacgaggtcaggagattgagaccatgctggctaacacagtgaaaccccatctctactaaaaatacaaaaaaattagccaggcatggtggtgggcacctgtagtcccagctactcaggaggctgaggcaggagaatggcgtgaacccaggaggtggagcttgcagtgagccaagactgcgccactgcactccagcctagacgacagaacgagactccatctcaaaaaaataaataaataagaaagtgaaaatatgaaaaaagacattccaagcaaaaagtaatcaaaagagagccagaatggctatattaatattagagaaaatagactttaggacaaaaattgttactagagacaaagaaggatattttataatgattaaagggctaatcaacaagatataacaattacaaacaaatatatacctaacaacagagtcccaaaattcaagaagcaaaaactgatagaattgaaggaagaaataagacaattcaacaaaaatagttggggaattcaatagccccactttcaataatgaacaaaaactctagacagtaggtcagttaaaaaaaaatcgctccctctccctctccctctccctctctctccctctcgctctcgctctccgtctccctctttctaccgtctccctctcttgcagagcctggactgtactgccatgatctcggctcgctgcaacctccctgccttgggctccggtgattctcctgcctcggcctgccaagtgcctgggattccaggcacgcgccgccactcttgactggtttttgtatttttggtgcagacagggtttcgctgtgttgaccgggctggtttccagctcctggcctcgggtgatctgcccacctcggtctcccgaggtgctgggattgcagatggagtctcgctcactcattgctcaatgttgcccaggctggagtgcagtggcgtgatctcggctcactacaacctccacctcccagccgcctgccttggcctcccaaagtgctaagattacagcctctgcccgcccgccaccccgtctaggaagtgagcagcgtctctgcctggccgcccatcgtctgggatgtgaggagcccctctgcccgcccgacccatctgggaagtgagaagtgcctctgcccggccgccaccccatctagaaagtgaggagcgtctctgcctggccgcccatcgtctgggatgtgaggagcgcctcggcctggccgccccgtctgggaggaagtgaggagcgcctctgcctggccgcccccgtctgggaagtgaggagtgcttctgcccggccgccaccctgtctaggaagtgagaagtgtctctgcctggctgcccatcgtctgggatgtgaggagcccctcttcctggccgccccgtctgggaagtgaggagcgcctctgcccggccgccccatctgggaagtgggcgcctctgcccagctgccccgtccgggaggtgaggggagtctctgcctggccaccccgcctgggaagtgaggggcgtctctgcccggccaccccgcctgggaagtgaggggcgtctttacccggccgccaccccatctgggaagtgaggagcgcctctgcccggccgccccgcctgggaagtgggtgcctctgcccggccgccccgtctgggaggtgaggggcgcctctgcctggccgctgccccatctgggaggtgaggggcgtctctgcctggctgccccgcctgggaagtgaggagcgcctctgcccggccgctcttcgtctgggaggtggggagcacctctgcccagccgccccatctgggaagtgggcgcctctgcccggccgccccatctgggaggtgaggggcgtctctgcctggccgccctgtctgggaggtgaggagcacctctgcccggccacccagcctgggaagtgaggagcgcctctgccaggccgccccgtctgggaagtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtactaagaaaagttcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcatcaccgttccctaatctcaagtacccagggacacaaacagggccgaaggccgcagggacctctgcctaggaaaaccagagacctttgttctcgtgtttatctgctgaccttctctccactattatcctatgaccctgccacatccccctctctgagaaacacctaagaatgatcaataaatactaaaaataaaaaaattaaaaaaaaaaatcagaagacttgaacaacactttaagccaactagacctaacagacatcgacagaacactccacttaacaacaacagaacacatactcttctcaagtgcacaggaaatattctccagaatagaccttatgttaggccataaagcaaatctcaataaatttaaaaggactgaaattatacaaagtatgttctgtgaccacaataaaataacagaagtcaacggcaaaaacaatctgggaaatttacaaatatgtggaaattacacaacatattcttaaataaccaatggaaaaagaagaaaccacaagggaattctcaaatttacttaagtaaaaatactatgaaataaatggacatgaaaacataacatgccaaacttacggaatacagcaaaagcagtgctgagtttaaaaatatatatataaaactataaatgtccacattaaaaaacagaaagttctcaaatcaacaacctaacattccaccttgagaaactaggaaaagagaagcaaattaaattaacaaataacagaagaagaaaatactagagtgaaagtaaatgaaatagagagtaaaaaaaaattgagaaagttaatgaaaaaccaaaaatgggttctttgaaaaataaaactgacaaacttctaactacactgaacaagaaaaaaatagagagaagactcaaattagtaaaatcagagaggatattaccaccagctttacagaaataaaaagcactataagggaatactatgaacagctgtttgccaagaaattagataaactagatgaaatgggaaaattcctagagaaacacaaactctcagactgaaacttaggtcagaataaacctataacaagatattgaattagtaatcaaaaaacttcttgcccacaaagaaaagcccagggccaaagtcactggtgaattctgccaaacacttaaagaattaacaccaatcccttacaatgtccttcaaaaaatagaatacaaagcactaaccaattcattccatgaggtcactattgccttaatactcaaactaggaaacaaaatcacaaggaaaaaaactataaaccaatataaaccatccataaatgtagatgcaaaactcctcaacaaaatattagcaaatcagatccagcagcatattttgtaagtattcatcatgactaagccatacgtattcaaggaatgtaaggttagatcaacatacaaagatcaatgtaatataccatatccatagaccacataatcatcacaatagatgcagaaaaatcatttaataaaatccaacatcctttgaagatttaaaaaaatgctcaacaaacaagcaactgaagggaacttcatcaatccaataaaggatatctgtgaaaaatccagaacatcacagttaattgtagaagaccaaaagctttcctcctaagatcaaaaacaaaacaaatatgtctgctcttgcctcttctatttaacattgctctggaggttctggcctcggcaattggataagaaaaagatataaaagacacccatattgaaaagaagaagtaaaactatctctatttgcagatgatctcatatataggaagtcctaagaaatacacatacacacacagacacacacactattagaactaataaataaattcagcaaggctataggatacaagatcaatatatgaaaatcaattgtaattctatatggtagtaatgaacaatctgaaaataaaattaagaaaacaattcaattcgtaatagcatcaaagagaataaaataattataaatttaacaaaagtataagacttgtacactaaaaactacaaaacatagttgggagaaattaatgtagacttaaataagtggaaggacatcccatgttcatggattgtaagacaatattcttcagatggcaatactccccaaattgacctacagattcaatgcaatccctatcaaaattctagctggcttttgttgttgttgttgcacaaattgacaagctgttcctaaaattcgtgtgaaaatgaaagggacctggaacaaccaaaacagtcttgaaaaagaagtacaaagttggaggactcacatttcctgacttcaaaacttactacaaagctacagtaactaagactgtgtggtaatggcataaaaatagacctataaatcaacagaataaaggtgagagtccagaaataaacccacacctccatggtcactcaatttttgtccagagtgtcataataatctaatggggaaagaatactctcttcaacaaatagtgctgggacaagcagatagcctcaaacaaaggaacacatttggatttgtacctcgtaccacatataaaaatgaattccaatggatcaaagacataaatgcaagacctaaaactataaaactcttagaagaaaacaagtgtaaatctttgtgaccttgcattaggcaatagtttcgtaaatatgacaccaaaagcatgtgcagtcaaattttaaaagagataaattggacttgatccaatttgaaaaacttgtgcttcaaaggacactatcaagaagaaatgggaaacactaccctcagaatgggagaaaatatttgcatgccatatatgttatagggtctagtatccagaatatatgaagaactcttacaattcaatgataaaaagatagcccagttaaaaacgggcaaaggccctcatggacatttctctaaagaagatgtacaaatggccaataggcacattaaaatttctcaaaattattagttattaggatttcaaatgcaaatcaaaaccacaaggagacactatctactggggtggatataatagaaaagacagtaataacaagtgttactgaggatgctgagaaactgaaactctcatactttgctggtaaggatgtaaaattgtgcaatctattcagaaaatgatcggtatagttccttaaattgttaaacagagttatcataggacccaacaattccgctccttgtattccacaaaatatttaaaaacctctgtccacacaaaaacttgtgcacaaatgttcacagcagcattcttcatattagccacaaagtggaaacaacccaaatatccattaactaatgagtgtggtttatccatatgatggaatattacacagcaataagaaggaatgaaataccaacatgctacaacactgaagaacttgagaacagtatgctaagagaaggaaatctgacaaaaaaggccatgttgcatgattccacttattcaaatatccagaataggcaaattcatagagtcataaaatagattagtggttaccagaagctggtgggttggggaaggggcagtttgagggataattaagaagttctgggctgggcgtggtggctcacacctataatcccagcactttgggaggcctaggcagacagatcacctgaggtcaggagttcaagaccagtctggccaacatggtgaaaccccgtctctactaaaactacaaaaaaattagccagccatggtggcacacacctgtaatcccagcactttgggaggctgaggtgggaggatcacttgagctcaggagtttgagaccagcctgagcaatatagtaagaccccccatttctatttataaaaaataagattaaaaaaaaaaaaaaaacatggccgagtgtggtagctcatgcctataatcccagcactttgggaggctgaggcgggtggatcacttgaggtgaggagttcgagaccagcctgacaaacatggtgaaaccccgtctctactaaaaatacaaaaattagctgggcatggtggcacatgcctgtaatcccagctacttgggaggctgagcccagagactcgcttgaacctgggtgacagaggttgcagtgagccgagatggcactactgcgctccagcctgggcaacagaatgagactatgagactcggtctttaaaaaaaaaaaaaaaaaaaaaaagaggttctggaattagagatgatggttccatttgtgaatacactaaaacccactaaatcatgcactttaaaagggtaaaatttaagttatgtgaattatatatttcaatttcttagaagaaaagatgacgatgaccaacatcccactaccaggacagcactcgatgaccctcacaggcaccacaatctaacaggtgagaatggtctcactgcaggcttaatttgtattttgttcattatgaatgacagtgagctaataaggcatttttttttcttgaatggtgtgtttggggtttcccctttattcaactagtctgtagatttttttcttattcatttttctttggcctgagtttaaggctaggtaatggtattcattcatccaataactgtatcttgagggcttagggttgcctcgccctgttctaggcagtggaatatggtcataaacatgacccacagagtcctgggcctcatgaagcataaatggtcaaggggagacacaaatactaaacagggaaacacacaccagccggcaacaagtgctgtggaaaaaactagagcaggtggggagagccaggagtggatgggggctctgttggtgataatatgggccagctggagaaggctcctcagatgaggtgacttctcacccacatgaagcaatccacgtagggaagaactgaccccagaggaaacagacactccaggcaacagaggaaagcataaaaagcaattgtaagggagagagacctggtcacctgtgtccatctgaggagcaggacgccatggctgagaatcaaccagactctaagaacagtagccaagacctgtagccatctcctcactgccccacacccacaccactgccagctcccacctgctgctgtgctacccacttcccacgtctgaccatctgtatgtccatcctccctggtaagccctcatccaagtggccatccactctccaatgcagggttgcagggcccccactccaccccagctaaccatgctcttctgagtcacggtcctgggggaagggggttctgttggcctcagcttctgaaagcacttccgtggctccaagaaggaagacagtgctggtgatttggccagcaaggcccagcctcaccctctctccccattgctgttggctggctctgctcccccaggcacacagcggtgcagggtcctgcccaggccagctgacatcactgccaagatgggactgaaatgtcagtgtctgcacacagctcgggccagcaaggcatcctggaccctggctggccctggggcttcctgttccccttgcctgccaagcagggccaactctgtgtccctcagaaggagccagctgggaaggcctgtggtcaggaggaggtgggccccagagtgtcccccaatcctcagagtccaaaacagaggatgttcctgcccccaccaccggcccccacgccaggaagctgctgcagccaccagggtctgatgctgcctaatcagggaaggtgctcctgcagggactttcacgtgtgtttaaaagcaagatttaaaagcaagattattcagtgctctccctcggggaaagtcccctggggagagggcacagtgctcacagcagggtccagcggccagggcaagcacaccacctctgtgtctcccaccgagggagctggcaaaagcccttcacctttctgaacttcagtttccacttctagaaaatgtggtgaatgccatgcacctgaaggaccggtgcagctccctgcgaggcaccttctctggcactgtgtacccttggccaatgcgcagtctcggagctatggaggagcgctgcctgggagccagctgcccggacactggtttcactacagctggggagaggagggccacctggaatgggggaatggggagagcacctgtcatggacacacctgagcagctatgacggtttccctgtcgggggacgcagagaccacctcccaggtccatatgccatcaccagccataggacacagtcgtcccagctgacccaggacagtgccaattccgcctgttgcttgacataagtcactctcagaaagtgccccaccccacccaagacgactgctagaaacagattcctgggctccgcccccaggccgagtgaatcagagtctgggggtgtggctctgaggttggaatcttctgccagctcagtgggagaccccagcacacagccagacttgagaagccccaagtgtggggtgtgccgaaggggaaggggggggtcaggcaccctagagggttccttccatgctccattccacagaggctccttgcttacatctgcccctcacctagccccaaggtcaggtcaaatgtcaaaagcacatgaggggcattgtggctccgctgttttcccacctgtcacctggtcaatggcggcttcccagctggaaggggcagagagggctggaggcttgggagtggtggtcctggggaacaaggctcaatggacccaggcactgacccgcaaccctgctgaagccagagacacctgggtggaggtggagacgtgcaggcaggagctgcccagggccaggcagaggctccagcagcgagcctcacagctgaagggaatgtgtgaggaggggcctgggccttgctctagggagcacctctgaggctgcagggcgtggaaggaagtgcctattccctgatggaggccgggaaggtgccagaaacccagaaatccaacaggaagggctgcaggaagaggcctgctctgctggctgggccctgatggcactcttctgcaacccaacctctgagactcagttttccttcctgccgcagtcccagcatgcagcactgatcagccagcggcagccgcctggggccctcatgaaaagcaccctgtgggttcggcaccaggtccctaatatccccccaatatgaggactgtgtgcttcccatctgcaccccgctgctgcctgaagcgtcttgtggggcccctcaccgtgctaggatttgcacctcagctggagtcccctaggaggcacaaaggctggagcaggaacagtgtggcttccagaacacactcacgcatgcccaggaaagaaaaagccacacagattgatttactgcttctgctttgccactgagcacaaggtgtcagtgtgcatgatggacgccagccgctgtgaaaattgagatgtcagcccagagcccacagcccacaccacctcacctccagacgcagtcaggggtggcacagtcctgttaattgcgagccctgagcagactgcgaaacgtgcttgttgagcgctacctggggagctcaccctgtccagacggttgggaatccacactctctggctcacgggacacctctgcttctgcctccctgtgcacagccacccctccaggactgtgagggggaccaggccttcgtctggcccagcactggtgtggaccagacccctgaccctcacaagtaccagttctctccttgctgttgtcaggttcggaagggacaggtgaaggtgctgtgccacagggagtctccccaacaagacggacccctggtgatgcaggagcaggcagacagggaggccctgctggatggtagcggcaccctgaggacacacagggtggtgtcgagctcccacctggccctggccatgaggagtgttgtcagagggtgaggacgcagagggcacctgtcgccattgatgctgggatgaccaaggacagtgcctggggcaggcccccagaagcagagggggcttgggggaatagagggctgacccaggcactcctgtgtgtgcacggtactgccacccacccacatgggtgtgcatacacaggcacactccacatcgtggacacatctttagtttcaagggtgtcagcaggtgggacacagagcagtgcaccccagaaggagcagacagaccagcacacccacctctccacagccaggactaggtgggcaggggaaccaggccaggagtcaagggcctggccaggcacttggagttggaaggcagggaggaaggggtgggctacggggctgcgggacaggccggggctcggcatccagcagctctttctagtaggcaggcctgcctgggaaggaagggcagggcattaatgggtagtcagtgactctgtcttccaaacccaactgcctggccaggcccttgacttctgcttagccatggactcccaggaagggaggggacgtgactgtgaggcagacacagtgcactttcttttctgaaggtctgatttcccctcacatgtcctaagctcaggggctttttagcacagacagaggacccggtttcagggctcggctgccaaactcacctgactcccactggcaatagagcccctccacagaggcttgcaggctccctctgctgcacacccagtgactggctcgcggcgggaggcagcacccgagagaggaccctgtgcctcctgctcaccctcgacacagacccactgggactaaccgctcccctgcaccctggcactcatcgtccgcaccccactggaacccacaatctgctgccaacaaccccagctctcctcacagagcaccgcaccccacgccttcaggaccagcgagttcaaaggagcccatcgtgggcaaacccccatggtctcctctgtccatgccccagacaaaggggctgtgcacacccagcccagggagggcccacaggcgggggtgcccccacacacttccacgcccaccgtagcaaggccacctgcaggaggggcctggccaggtccagccttcctgacacccaccccacaccccccaccacctcatcctgatgtgttcagcgggtgccacaacctccaaactaccccgtgtgtggatttgaggtccttgtagctccccagactgtaaactcccaaatccccggggagggctgccttgctcacctcatgtgagggattaggctctcaagagtgggtatggcccccaaatatgcccacagcctgatctccagaacctgggaatgttcccgtattcggcaaaagggactctgtaggtgtaattaggcagaggctcttaaggctgctgggagattctcctgggtgggcccattgtattcacaagtccttaaagttgaagaatctttccccgctgcagtcagagaaagtgtgaggacaagacagggtcagggagatggtggcgtcaggggacccaacacctgtggctggctcggagctgtagggagcctcacacaaggcccagagggggctctaggggccctcaggggccaacatcccacaggggacggggacctcaaggaatgagattctaccaacagacacctgcgtgaccacgattctgcctggagcctccgaagaggcaggccggccagcgccttgacctcagcccctaagacccgacccagcctctgacctactggccgagataagaagcatgtggtgcggaagcagctccatctgtgggacttttttgcagcagcaataagaggcaggggcagcccaccctgctttgagcaccagccggctggccacaggcacagaccacaggggcaggacccctctagggctcacccggcagtgcccctaagctgggcctggggcaggcctgcctccccatggggtctggcaccatcctccccaccctcaggcccacagagggcagacggagactcacatgccaggcccagtgctcggtggatggcctcccaccagggctgtgctctgtgaccccagctgtgcaaggaagtgggctgcaggaaaatatcccctgcaggaaaccctggagccaggacacttcagggagggcgggagacaaacagagggggccttcagggtcctcttgggaactgcaatgtgccagtggcaccaggacagctgtggggccatggagggctgcaaggggccatgtaggtagacccccccagtgctggcggcctccacttgttgcccccttagatctgtgtggtggggcactggccctcctgctgagggcacgggtttcctaacaggcacctatccttcaagctccttgggcctggcccagaccttccagccctgtgggctgtgctcttcctgctggtcctgcctgccctctccacctcgggcctcacggctgcaccgctaacccccgcccccggacctggtctactgttgcagggcccggaactgacaccttcacactcaggtcacagcgcagtgacacccggcctctgggcctcagctgctggcagaaggctgggtgggggctaggtgggggctgggagtccataaggctgtgctccctgagcaagtctctgtggtcacaggcaaggatggaaaccgctgctgtagctcagaggtaaaacgggtctctgtgggatgagctccaagcaggggtccaagcaggggctcctcctagggtccccagaataatccctgactaaagggagggaacaaaggagacagtccctttatggcacacaagcaatgacaccagtgactccattgggtctgacattgggacctccttgtgtagctggtagccccagggcccactggaggcccctctatccccgcactcctgacacactcggctgggaacactggggactttcctcctgggcagaggctccccattcccaggcatctggagaggaaaccgggaagtgtggggtttccagcacctccgggaagccccagccaccacctggtctctgcctggcagagtccagccccaccagcccagcccctccagccggtgtcgggcttggctgcagtgggaatgcccagcaggaaggacagcaggatccaggaaatctcccaaagtcactatgctgcacggccccacccaggccccagcgccctccaggcccctcacaccacctaggccaagccgcccagccctgcccgcctaggctgcccactcagcatcgctccttcctgccccacccactgccatctgggcctggacggctccaggatatcctggacagtggggcaggctgaggtgagagagctgaccactgtcctgacccagccccagggctgcaccctcatccaaaggctggggacagctgcccccacctcctcttaggctgcaagctctgggggcaggcacactcctcactccttgtctcacagccctgcccagagcctgcacctggagcaggacaggaacatcacagctctgccatgtaccctctgcagccaccactctgaggaggtgaggagtgtcactggcatttcatagcagcacagactgaggccagaaaccggaagtgtctgtccaaggacacaggacactggtcagggccagagttaaaaccaaaacccagactcccatgtcaggggaaccctggagccagggctgggggtgctggggtgggagtaggcacaagtgttggctcaggaccaccaggtggtgggtgtgtggccattcctgggcacctgtcacccttggcttctctgggctggctcctggcgctgtctgcccactggcaccccactcccccagaggagcaccagtctagagtgggggtgcagtgtggtctgggcttctccgatgccctccttcctcccctggttgccaacaatgctaaagctgcacgcctgtgatcagggaggccctctcagcttgactgctctctcctgccccctagagctaccatagtgtttagacagaggccatccccagcctagggggagcactgtgcaggaggaggcccccaggggacccagagtgaactgactttagggagcccatgctaatgactgtcctggccacactgtgccccacaagccacaggtggagtgaggatgctgagggggcctggagccaggacaaggcaagccaggcgggggcaggtgcggcaggtgctgctggagtcccccaacccctacccagaacacacagcagcctgcatccaggcagccagtgcggagcttggttcttgatccggctgtgactggctgtgtcctccctggaccatgtgctcagagatgggacaagggctgagcggcttgtcacaggcagaaagaagaacaggaacaggaacctcagggaaagaaagggctggttgggggtggagggggtggtgaatcaatagccaagggaggtgggtgaagaaagtgaggtgcagcaggtcaaatacgcagaccagagtggcctctccaggatccctgcccacattgtaatgcatgggctacctctctcggcttccagggcactgcacactcagtgcgactctggacctcagccgcttcccccacacagtctcccgtccctggttctctccacgttggggctgaggatgtgtctggtgtggaccagcgcacaccacagccacagagcagtgcccccactcgcgccatctgcacacagacacagatgagccgtgaaggtggcatgaaaccccgggcctctgttccccgactttcttgccattccctggttgccggcaggagtccatcttggggcccagctgtttcctctacaaccggaaacccccttcctcccttcatggttttgcccaaacctggccttcccagggtggctgccttcatcgctccctcctggcacctctccctccttccagaatcattaggctcatttctgtctatttttaggttgtgtctgcactcccagagtctgggccatgcctggcgtgcatggcctgcagtgggtgaggttgtgatccgacatctctccccaggtcaactttccactctccaatggttctgcctgagtccatctctcaggtgggggtgagggtgagcagcaccttgcagaatccctcacatggctccagaggtcacagcaagagggaggagccatgaggcctgggttcacaccctggactggccacttctcgttatcagcaccagcaggactcttgacccctccaagcctcgctgacacactggtgatgatttgcatgcccaccctgggcccacttgtgtctagacacccctcaccaggtgggcagctcatcagccacatggggccttgcccagcgagtcccacccatgcagtgtttggtggggaaggaggagcacaggtcccgcccaggaggcaggattctgggactgggcctgcctctgccgcctgggggcctctcctccacacctcagtcccatctggcctgcaggcaggttccagcaagctacattctccttcctaggagggtggggatgttctcagaccccgtagtgccctgcgcttcccccgggcctccccagggggtagtgactgcacacagcgatgggcaacaacagggtccagggtcccgtcagcggtgccctccccattctaaagcaggcctgggactcacattctccagagccagccctggccctgcattatgctgcactgaccattttcacatgtgctgtataatgtctggttgaggccaggggttctcccctgggctcccacagggctgcatggctgtccccactagccagggaaaggtgtgtcccctaggactgacagacactcctcccaccatccaggcagccagtgctctggccgaggcagacagctgcagcctggagaggacagacagggcgaggcaggggaaggcagctgcctgggccaggacatgagggcctccagtgttacatttacaggaggctcagaaaacaactaggctgggcaggtttccagtgggcatctggggtgaactccttccccattcaggatctcaggcgaaagctgcctctatactaggtggctcacagcttcggggaggggtaccctcatggaggtctgcctgctggagcccccagaaccctgcgccagtcaactcttcattgaaagatagggaggcgcagtttcgtttaactcaattttgcagcctccatcatctgagtgggtgggtatggagtgtctcatcttgaggtgagggattctgtgagcgggaggaccccatggctggcctggcctctcaggaggctgaggtgagggggctgtggaaggtgaagtcgcccctcctaatatggcagcaggagggtgaagtctagcctcggtcaccacttcccctgccccatgccacctgccctcctctttcatggccaacccagtgccccacctacctcagggccatctgccactctgcgcttgacaccagaggacaagtgcatttccttggggcaaagctgcaggccacagcaggcggctggccccttgggacgaggagagcagctcagttttggtgggccgaggggcaccaccagcagggagcctcagagagcctagcaggcttgggtgagctactgagctgcaggcttgctggatggatgccccacaggccagcccctaggagcaggactgcctctgtctcctctttgtgccacccacacccaccatccacccactcagcacagcctcttcatgcctggtgggctctcagggcagctcatgtgctgccacctgggctggccctcctggcaagctggaagagctcactgggcacatgggcctcctgaccaccaggcccgggaaggacagctgggggccagagtggagagaaggctgcagcaggggctgatgtgcaggccccagactccccggccagtgctccccaccctgcactgccttcactggcctggggctggccctggtctctggttcccccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcagggccaagtggctccccagacccagaccccacggagaagctagggtccgcccccctctcaggaccccagcaggcagactcccgtgcccataggaggcctggccactgtcccgccccctcccacctttcccactgcgggagccaaggaaggcacctgggtgtggacttctcctgtacaactgggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgggcatctccgagccagcactgactgctcagcctgtgcgcacccaccaggcttggtgggtgcctggtgaccgcagctgtgggtctcccctccaggccccacccatgtgggagcgccctccccctcggccccgccccctctgggaagtggttctggctgccgtggcctttccatgaagaacagctgggacccctggccatacttgccagcacagtttactatcagccctctccaccaccaccactccccgcagggcagttgatctggcccaggtacctgcaggtcacctcacagcaggtctaactcactccagcttggtcaaggtaagcccagctcccagaaacacctaggccagaggaggaaggggcacggggcatagaaggccctgtccccgtagcggggctgagcaggaagggccctgcctgcaatggacagtgtgggcaggacttgggctctcccaggtgccaccaatgctcacctggcctggcctcgccagtgggggactccactcctcatccagccacccactgctaacagcaataataaaatgaataattgatgcagccccctgcctgctctgagtaattaactcatgaaagcatcagggcacccccagaactcccaacctcatccaagccccatcctcccagctggtccactcaccctgcctccagcccacccttcctcccccagctctgagggcagaggcttgggtcctagcaactggggccaaccctcctctcctcagccagcaaagccggggctgcccagctctcacccagagcctggctcggggctgcacattaccttcatccagaccacagccctgggagaagcagggctcacagggcatgctcagagcaccggccagaaaaagctgggcacagaactagcctacagagaagtccaggcaggagaaatctggaccttggagtctgcgtctgtacagggacaaagtgcagatcctcatcctgggaagtacctggtgctgtggctgggcatgtctccccaggccccaaggaggaggcctgccccagtgccccagctgtggctggggtccaggacacacccggatgcactcaaggctgcctgacattcacatttggcgggtctgggtaccagagacctggagagccccatgggcagagagagtgggggagggtccaccagatttgggcagccttggtgggggtggggaaacaagccctgctgataaaccatcagaacgcgccccctctcctctcccagctcccgccagcctcctccacggaagctactctttgttaacagcgttgccatggcaaccagatccagggagaactctctcttcaaggtagagtctgagggtgacacttggagaaacagaagtggtggtgacaacaaacagggtgctggcctcccagccccaccccccaggattccttcctggtccaggaccccagacaccagccccccagactgtcccagagctctcaggtctgcttccctctcctctcctctccctggcgtgggtgcagcaacgtggcccaggccaggcacctctgccacaccatgcacggtggctcaggcacttccatgcacctcccacggatgttcgctgaatctgccagcatagccactgtctcgtggctgggctccaacaggcctggtgcagactagaccccaggggatcatagacaagtacacccaaggcggctgctgcagagcagccccgggccccctgcacagcaggaaagttcaggaaggcacccaaggaaggctgggagcctcctggcaggagggagacccagcagaagccatgccctgagtaggggaacagactgctgggtaaggaggccactgcaaatgtcctggccaggggatggtggcccggcccacagaggtggcagtgagcagggagaggcagaaggggcagaagagaggtctagagtggggtgtgctagactggctgacaactccaggcaaagggaagctggcagagggggtgagggagagccagctgcctacctgctcagatggggaacctggggcaggcaaggttcaggggcgtgatgatgtgcatcgtcacccgggaggcgtccagcaggctcacacactgacagaacccagaggacaggtgggggctgatgagagctggaaccggatcagcacggaggagggaacagatgctgtggctgggtagagggtttgagcccaggtcttgaggaacagggactttgagtgtcccaggatgggaggaggagaaccaggggccggccaagcccaggaaatgggtgtctgggaacaaggcagtggacatccacggcctctcaagaagacatccctggactgaaggaggtgtgtgcagattggcgtgggtgggagtgagtgggaagtgaggattcagagtgagcagagaacatgtcttcaaagtcagcccgcacaggcgaccagggtgcggacggctgagcaagtttcgttgtttttaaaaaaggaaaagcacctgtcaaccggacagccacatctttgcatcccacgtatgaagtgcccaccctgggctgttctgtctagagtcccagcccaggcctctcttcttcaagctggtgctggcctctgctccctgaattcacaaagaaccccacagccagctcacaagagacaagcaggtctcggagcccctgctggctgccctgggcagcacaggccggcagctcagcccctaccccagcccgggcagtgcccagggcagggcgggcaaccacaggtggggagaagcttcccagaacaggatcactgggtgtcgtcctgagttgtgcccaaaggcacccatgtgcttcctgggaggtgctgcagcagagccgggacaaccggactactctccctgcctggcttccctctccatggtccaccgggcaggggtggccacagcagcagtcacacccccaccccgtccatcacagcacaggccccgcttgagtcctcacacctgtccactcctggccggtcacccctcacagccctctgtcatggtgcctggagcagcctctaccagcctgtcccaggtggtgagccctgaggccagagcccctctcccactctgagcaggccaggaccccgaggggctttcgggcttcccttcacacagtgcccgccaagccactgctggccataccagctgaccttcccaaaccctgctcccgggctgctagctggggaattcctggtgtcccagcgcgcagggacattctgcatgggttcctggcagctcgccactctgggccggcccagagcccactctcacatacccacagccccaggctctgtgcccaaaaagtggcgacagggatacacccaaaaagtgggcagtgagccctctctggacccccgcaggtcaggctgacagccataggggagggcctctgacacccccagcaatccaccagtgggtatcagaggccctcctctatggctgtcagcccaccagtgccacttcagtcccctccctccgcacatcacacccttgctaggtaaacactcatcctccccagcagggagtgggcaggggagggcagaggagccgggaggcaggctggagtgggtgggagttacaggaggcagattggaagctccaacagaaaagcagccagagtgccggacccaagcagatggcctcaggagaaaaagggggaaggggagggagggtccgtcaaggggcagcagggaggggtgggggagaatgccttgagtctcctccccatctgctatctgctatgcccctggcacctacccccagcagcccagcgcccctcccctggggtgggccatgcagagaagagcatccctccaccagcccctctcctgaggacagtgggggggccaaaccccctgcccccatccctgccttggcacagcaccttcacttgacctatttgacaaatagggcttctgtgaaacccacggttctattgccaaaaaccaaaggccaaccaaagctgtcccatcctgcccctggcatcattctacaggtggggaccggcgtgctcaggggctcctggccacactgtgtcccagtgcccactcgctctcctccctggctggcccctcccaccgctgggggccactgtgtgcgtggctctccccaccgcagccactgtccagcacaaatgccatttctccctcctcctcctcctcccctgcctgcagttgctaagttacaccaaaaaacccctctgctctgtgtgaactgttccatttccacgatttgccaggtggaagggagccatccggctggcagctcgaagatgcctcccagagaaaaacaaactcactggctggccttcaggccaaggcacacctgggatacctgcttggttcacaaacccaggggcatgtgcaggaggacacagcttctctacttcactagagagcctgggggatccacacagctcatgcccttctcaggagcagggagtgtgggcctgctgcacccgcctcgctgggtcactaccacccacagccctaaggacacacactggctggaggggcagagaacccacccacgtgtccctggccatccagccaaggtcctccatgtccccctgctccggatctccccttcctgggctggggtcctgaggttccaaagcaaagtgtcactggacatcagggtggaaatgtcctcagaggtcatcaaaaccgtgtcagtctacagatggggaaactgagtctcagaagcctgcagcctgcccgtggttcacgaatcaagacctgtagcctttcggctggaggccccctagagccgcttagagtccagggcaccgaggtggacaggctgggctggcaagactgcatccggagggggcgggagaaccctggggggacagagggaaccaaggcctctgggaggctcccctgcacccagcctgactcctgtgtttcaggatcctgcggccgacggccatcggggcccttcctgcgcaggacagtgggagaagagtggcagtggtggggagggtgaaccagggagaagctcactgctctgagcagggagggagggagccccggccaccaccaggtctctgcccccaggtggctcccaagaggcaggcagcggcctctctgtaaatatccaccaggtccagcacccagaggcagccagaaatgcagggcacaggaacctgccagcgcgtccctccacacacagcaggggactcccgcccccacctctcactcaccgaccctcggaccagaaccagctgcacctgccccgttcctggggccggcaaggcctggggcaaagagagcgtggtccttcaaatgacccttgcccagcagggagagggagacacctggcatggccctggacctctcccccaaatgcagagctcaagccccaattcctcgccaaacagcaagggcgtgagataccacggcggggcccagaatgcagaagagcaaatggaaacttccaactgcgcagccctgagctcctccgattccccagcccccacccccacgccaggccccgggcagcgaacctgcccgcagtgcccacgcccgcccgccgcgtgcgctcctgccacgcccggcccggcccggcccggcccgccaggtgccctgaaggggcggagggtgcagggggtcctggcgccgtccagcccggggcggagttctcagcaactccgcgcgccgggatcccggccgccctccccgcgcgcgtcccccgccccgcgcccggagcccgcgccccggccccacgacggccgcgccgggagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgcc

SEQ ID NO: 1636 - DNA, 50436 bp, Homo sapiens
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattt

SEQ ID NO: 1637 - DNA, 53281 bp, Homo sapiens
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataa

SEQ ID NO: 1638 - DNA, 1745692 bp, Homo sapiens
caagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatct
